United States Patent 11,931,406 (FLAVIVIRUS VACCINE) - sequence listing, part 46

SEQ ID NO: 17067 - RNA, 9876 nt, Artificial Sequence
  derived and/or modified CDS sequence (opt4) from DENV-2__FJ639704__SS-prME
agcgccggcaugaucaucaugcugauccccaccgugguggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaagaccaagaugcugagcaccgagagcuacaaccagaccuuccugaucgacggccccgagaccaccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacaucagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17068 - RNA, 9876 nt, Artificial Sequence
  derived and/or modified CDS sequence (opt4) from DENV-2__GQ868622__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccagacagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagaagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17069 - RNA, 9876 nt, Artificial Sequence
  derived and/or modified CDS sequence (opt4) from DENV-2__FJ639705__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccagacagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugagccugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17070 - RNA, 9876 nt, Artificial Sequence
  derived and/or modified CDS sequence (opt4) from DENV-2__FJ639706__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgcccugcugagccagagcaccauccccgagaccauccuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcguguucaagaacauccagcaccugaccgccaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17071 - RNA, 9876 nt, Artificial Sequence
  derived and/or modified CDS sequence (opt4) from DENV-2__FJ639707__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacauccugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccaccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucaugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccuggccgccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgccaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacagcagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcuggugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17072 - RNA, 9876 nt, Artificial Sequence
  derived and/or modified CDS sequence (opt4) from DENV-2__FJ639708__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacauccugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucaugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17073 - RNA, 9876 nt, Artificial Sequence
  derived and/or modified CDS sequence (opt4) from DENV-2__FJ639709__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagaccaccauccccgagaccauccuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcuguggaacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17074 - RNA, 9876 nt, Artificial Sequence
  derived and/or modified CDS sequence (opt4) from DENV-2__FJ639710__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcgccaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccugauccuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcagaagaagccugagaccccagcccaccgagcugaaguacagcuggaagaccuggggcaaggccaagaugcugagcaccgagagcuacaaccagaccuuccugaucgacggccccgagaccaccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgaguggaucaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacaccagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugaucuacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17075 - RNA, 9876 nt, Artificial Sequence
  derived and/or modified CDS sequence (opt4) from DENV-2__GQ868623__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggccuggcccuguuccuggaggagaugcugagaaccagagugggcaccaagcacgccauccugcugguggccgugagcuucgugacccugaucaccggcaacaugagcgugaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaccaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaagcacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17076 - RNA, 9876 nt, Artificial Sequence
  derived and/or modified CDS sequence (opt4) from DENV-2__GQ868624__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaaggaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggaggccgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17077 - RNA, 9876 nt, Artificial Sequence
  derived and/or modified CDS sequence (opt4) from DENV-2__FJ639717__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagagcaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaccgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcaccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacaccggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17078 - RNA, 9876 nt, Artificial Sequence
  derived and/or modified CDS sequence (opt4) from DENV-2__FJ639718__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagaaggccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaaggaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacaacagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggaggccgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17079 - RNA, 9876 nt, Artificial Sequence
  derived and/or modified CDS sequence (opt4) from DENV-2__GQ868625__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggcagaauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaaggaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggaggccgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17080 - RNA, 9876 nt, Artificial Sequence
  derived and/or modified CDS sequence (opt4) from DENV-2__KF955401__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcguggccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcuguucaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaaggaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggaggccgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17081 - RNA, 9876 nt, Artificial Sequence
  derived and/or modified CDS sequence (opt4) from DENV-2__JF730047__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagagcaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaccgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcaccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacaccggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaucagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17082 - RNA, 9876 nt, Artificial Sequence
  derived and/or modified CDS sequence (opt4) from DENV-2__JF730048__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagagcaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaccgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcaccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagacagcuucccccagagcaacgcccccaucaucgacgaggagagagagauccccgagagaagcuggaacaccggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17083 - RNA, 9876 nt, Artificial Sequence
  derived and/or modified CDS sequence (opt4) from DENV-2__KF955402__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagaguguucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcguggccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaaggaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggaggccgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17084 - RNA, 9876 nt, Artificial Sequence
  derived and/or modified CDS sequence (opt4) from DENV-2__FJ898460__SS-prME
accgccggcgugaucgugaugcugauccccaccgccaucgccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucaacggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccaugcccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccgugcccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17085 - RNA, 9876 nt, Artificial Sequence
  derived and/or modified CDS sequence (opt4) from DENV-2__FJ882602__SS-prME
accgccggcaugaucaucaugcugauccccaccgccauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcguggcccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgacgacggcugcugguacggcauggagaucagaccccugaaggagaaggaggagaaccuggugaacagccuggugaccgccggcuacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugguggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgaggagguguucaagggcauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17086 - RNA, 9876 nt, Artificial Sequence
  derived and/or modified CDS sequence (opt4) from DENV-2__GQ252676__SS-prME
accgccggcgugaucaucaugcugauccccaccgccauggccuuccaccugaccaccagaaacggcgagccccacaugaucgugagcaagcaggagaagggcaagagccugcuguucaagaccgaggagggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacauccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugagcaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucgccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaucggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagggcauccagcaccugaccgccaccgaggagguggccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcagcgaggaguacaccgacuacaugcccagcaugaagagauucagaagagaggaggaggaggccggcgugcugugguga

SEQ ID NO: 17087 - RNA, 9876 nt, Artificial Sequence
  derived and/or modified CDS sequence (opt4) from DENV-2__GQ252677__SS-prME
accgccggcgugaucaucaugcugauccccaccgccauggccuuccaccugaccaccagaaacggcgagccccacaugaucgugagcaagcaggagaagggcaagagccugcuguucaagaccgaggagggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacauccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugagcaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugagaaagaagaagacccccagaaugugcaccagagaggaguucgccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaucggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagggcauccagcaccugaccgccaccgaggagguggccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcagcgaggaguacaccgacuacaugcccagcaugaagagauucagaagagaggaggaggaggccggcgugcugugguga

SEQ ID NO: 17088 - RNA, 9876 nt, Artificial Sequence
  derived and/or modified CDS sequence (opt4) from DENV-2__FJ898438__SS-prME
accgugggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcagcaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaacuucgaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacagcaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgccagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17089 - RNA, 9876 nt, Artificial Sequence
  derived and/or modified CDS sequence (opt4) from DENV-2__GQ199893__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagaaggcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacaucgagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagguguacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17090 - RNA, 9876 nt, Artificial Sequence
  derived and/or modified CDS sequence (opt4) from DENV-2__GQ199894__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagaaggcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagcacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgccagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacaucgagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagguguacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17091 - RNA, 9876 nt, Artificial Sequence
  derived and/or modified CDS sequence (opt4) from DENV-2__FJ898439__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcagcaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagaaucggcaccaagcacgccauccugcugguggccgccagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgagaccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucgugggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagagaaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagguggccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17092 - RNA, 9876 nt, Artificial Sequence
  derived and/or modified CDS sequence (opt4) from DENV-2__GQ868588__SS-prME
accgccggcaugaucaucaugcugauccccaccgugauggccuuccaccugaccaccagaaacggcgagccccacaugaucgugagcagacaggagaagggcaagagccugcuguucaagaccaaggacggcaccaacaugugcacccugauggcccuggaccugggcgagcugugcgaggacaccaucaccuacaagugccccuuccugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccaucgcccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccacccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccguggugaucaccccccacagcggcgaggagcacgccgugggcaacgacaccggcaagcacggcaaggaggugaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcuggacugguucagaaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucaccagcgagcugaaccacauccugagcgagaacgaggugaagcugaccaucaugaccggcgacaucaagggcaucaugcaggugggcaagagaagccugagaccccagcccaccgagcugagauacagcuggaagaccuggggcaaggccaagaugcugagcaccgagcugcacaaccagaccuuccugaucgacggccccgagaccgccgagugccccaacaccaacagagccuggaacagccuggagguggaggacuacggcuucggcguguucaccaccaacaucuggcugagacugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagauggugauccccaagaacuucgccggccccgugagccagcacaacaacagacccggcuaccacacccagaccgccggccccuggcaccugggcaagcuggagauggacuucgacuucugcgagggcaccaccgugguggugaccgaggagugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugagcagccuggugaccgccggccacggccagaucgacaacuucagccugggcauccugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcagcauccccgagaccauccuggagcugaccgacgcccuggcccugggcaugauggugcugaagauggugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggacgaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacauccccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucagaaccaacaccggcaccaucggcgccgugagccuggacuucagccccggcaccagcggcagccccaucguggacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagaaguaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaagaccggcaacgacaucgccgccugccugagaaagaacggcaagagagugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccagaaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccagcgagggcaucaacuacgccgacagaagauggugcuucgacggcaccagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacgugaucaucgccauccugaccgugguggccgccaccauggccaacgagaugggcuuccuggagaagaccaagaaggaccugggccugggccacaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccgugagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucgugccccccgagaagugcgacacccugcugugcgacaucggcgagagcagccccaaccccaccguggaggccggcagaacccugagagugcugaaccugguggagaacuggcugaacaacaacacccaguucugcgugaaggugcugaaccccuacaugcccagcgugaucgagagaauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgaggccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacaacagauucugggagcugguggacaaggagagaaaccugcaccuggagggcaagugcgagaccugcaucuacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucaccaucgaggaccugaagaacgaggagaugaucaccaaccacauggccggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccagcgaggagaucgccgugcaggacuggcuggugagagugggcagagagagacugagcagaauggccaucagcggcgacgacugcguggugaagccccuggacgacagauucgccagagcccugaccgcccugaacgacaugggcaaggugagaaaggacauccagcagugggagcccagcagaggcuggaacgacuggacccaggugcccuucugcagccaccacuuccacgagcugaucaugaaggacggcagaauccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagccacgaguggaugaccaccgaggacaugcugaccguguggaacagaguguggauccuggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17093 - RNA, 9876 nt, Artificial Sequence
  derived and/or modified CDS sequence (opt4) from DENV-2__GQ868590__SS-prME
accgccggcaugaucaucaugcugauccccaccgugauggccuuccaccugaccaccagaaacggcgagccccacaugaucgugagcagacaggagaagggcaagagccugcuguucaagaccaaggacggcaccaacaugugcacccugauggccauggaccugggcgagcugugcgaggacaccaucaccuacaagugccccuuccugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccaucgcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccacccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccguggugaucaccccccacagcggcgaggagcacgccgugggcaacgacaccggcaagcacggcaaggaggugaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcuggacugguucaagaagggcagcagcaucggccagauguucgagaccaccaugagaggcgccaagagaauggccauccugggcgacaccgccugggacuucggcagccugggcggcauguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggugggcaagagaagccugagaccccagcccaccgagcugagauacagcuggaagaccuggggcaaggccaagaugcugcccaccgagcugcacaaccagaccuuccugaucgacggccccgagaccgccgagugccccaacaccaacagagccuggaacagccuggagguggaggacuacggcuucggcguguucaccaccaacaucuggcugagacugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagauggugauccccaagaaccuggccggccccgugagccagcacaacaacagacccggcuaccacacccagaccgccggccccuggcaccugggcaagcuggagauggacuucaacuucugcgagggcaccaccgugguggugaccgaggagugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugagcagccuggugaccgccggccacggccagaucgacaacuucagccugggcauccugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuacaaggugagacccaccuucgccgccggccugcugcugagaaagcugaccagcaaggagcugaugaugaccaccaucggcaucgugcugcugagccagagcagcauccccgagaccauccuggagcugaccgacgcccuggcccugggcaugauggugcugaagauggugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagaaggccaccgacgugaagugggacgaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucagaaccaacaccggcaccaucggcgccgugagccuggacuucagccccggcaccagcggcagccccaucguggacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagaaguaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaagaccggcaacgacaucgccgccugccugagaaagaacggcaagagagugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccagaaacgagaacgaccaguacaucuacaugggcgagccccuggagaacgacgaggacugcgcccacuggaaggaggccaagaugcugcuggacaacaucaacacccccgagggcaucauccccagcauguucggccccgagagagagaagguggacgccaucgacggcgaguacagacugagaggcgaggccagaaagaccuucguggagcugaugagaagaggcgaccugcccguguggcuggccuacaagguggccagcgagggcaucaacuacgccgacagaagauggugcuucgacggcaccagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacgugaucaucgccauccugaccgugguggccgccaccauggccaacgagaugggcuuccuggagaagaccaagaaggaccugggccugggccacaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccgugagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagagcuggcugaacaacaacacccaguucugcgugaaggugcugaaccccuacaugcccagcgugaucgagagaauggagacccugcagagaaaguacggcggcgcccuggugagaaacccccugagcagaaacagcacccacgagauguacugggugagcaacgccagcggcaacguggugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgaggccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacaacagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucaccaucgaggaccugaagaacgaggagaugaucaccaaccacauggccggcgagcacaagaagcuggccgaggccaucuucaagcugaccuaccagaacaagguggugagagugcagagacccacccccaucggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccagcgaggagaucgccgugcaggacuggcuggugagagugggcagagagagacugagcagaauggccaucagcggcgacgacugcguggugaagccccuggacgacagauucgccagagcccugaccgcccugaacgacaugggcaaggugagaaaggacauccagcagugggagcccagcagaggcuggaacgacuggacccaggugcccuucugcagccaccacuuccacgagcugaucaugaaggacggcagaacccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagccacgaguggaugaccaccgaggacaugcugaccguguggaacagaguguggauccuggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17094 - RNA, 9876 nt, Artificial Sequence
  derived and/or modified CDS sequence (opt4) from DENV-2__GQ868497__SS-prME
accgccagcgugaucgugaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcagcaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaaggugaugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgccagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcgugaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcaucgacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagagagagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17095 - RNA, 9876 nt, Artificial Sequence
  derived and/or modified CDS sequence (opt4) from DENV-2__GU131959__SS-prME
accgccggcgugaucgugaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcagcaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacaccagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgagaccuggaagauggagaaggccagcuucaucgaggugaagagcugcuacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgccagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcaucgacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17096 - RNA, 9876 nt, Artificial Sequence
  derived and/or modified CDS sequence (opt4) from DENV-2__GQ868515__SS-prME
accgccggcgugaucgugaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccuggaucaccuacggcaccugcagcaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugagauacgagggcgacggcagccccugcaagauccccuucgagaucaccgacagcgagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugauccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgccagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagagcauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcaucgacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagaacauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17097 - RNA, 9876 nt, Artificial Sequence
  derived and/or modified CDS sequence (opt4) from DENV-2__GQ868516__SS-prME
accgccggcgugaucgugaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccuggaucaccuacggcaccugcagcaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugauccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgccagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagagcauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcaucgacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagaacauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17098 - RNA, 9876 nt, Artificial Sequence
  derived and/or modified CDS sequence (opt4) from DENV-2__GU131975__SS-prME
accgccggcgugaucgugaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccuggaucaccuacggcaccugcagcaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugauccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgccagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagagcauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcaucgacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaagccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagaacauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17099 - RNA, 9876 nt, Artificial Sequence
  derived and/or modified CDS sequence (opt4) from DENV-2__JN819422__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagaaggcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagacccagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacaucgagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagguguacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17100 - RNA, 9876 nt, Artificial Sequence
  derived and/or modified CDS sequence (opt4) from DENV-2__GU131955__SS-prME
accgccggcgugaucgugaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcagcaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgccagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcaucgacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17101 - RNA, 9876 nt, Artificial Sequence
  derived and/or modified CDS sequence (opt4) from DENV-2__KJ189311__SS-prME
accgccggcgugaucgugaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccuggaucaccuacggcaccugcagcaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugauccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgccagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagagcauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccuggagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcaucgacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaagccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagaacauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17102 - RNA, 9876 nt, Artificial Sequence
  derived and/or modified CDS sequence (opt4) from DENV-2__KJ189370__SS-prME
accgccggcgugaucgugaugcugauccccaccgccauggccuuccaccugaccaccagaaacggcgagccccacaugaucgugagcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagguggugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgaguacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuuccugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggugagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17103 - RNA, 9876 nt, Artificial Sequence
  derived and/or modified CDS sequence (opt4) from DENV-2__EU482620__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacaccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17104 - RNA, 9876 nt, Artificial Sequence
  derived and/or modified CDS sequence (opt4) from DENV-2__FJ373300__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaccaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccgugcuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17105 - RNA, 9876 nt, Artificial Sequence
  derived and/or modified CDS sequence (opt4) from DENV-2__EU596495__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17106 - RNA, 9876 nt, Artificial Sequence
  derived and/or modified CDS sequence (opt4) from DENV-2__EU596497__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaucaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagcuacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17107 - RNA, 9876 nt, Artificial Sequence
  derived and/or modified CDS sequence (opt4) from DENV-2__EU569695__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccguggccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17108 - RNA, 9876 nt, Artificial Sequence
  derived and/or modified CDS sequence (opt4) from DENV-2__EU482623__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccugcugcuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacagcggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaucgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17109 - RNA, 9876 nt, Artificial Sequence
  derived and/or modified CDS sequence (opt4) from DENV-2__EU569698__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagacagcuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17110 - RNA, 9876 nt, Artificial Sequence
  derived and/or modified CDS sequence (opt4) from DENV-2__EU569699__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccaaguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagacaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccugcugcuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccgugauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaucgaggagaucgccgugcagaacuggcuggccagagugggcagagagagacugagcagaauggccaucagcggcgacgacugcgugaucaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17111 - RNA, 9876 nt, Artificial Sequence
  derived and/or modified CDS sequence (opt4) from DENV-2__KF955366__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccagccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17112 - RNA, 9876 nt, Artificial Sequence
  derived and/or modified CDS sequence (opt4) from DENV-2__EU569700__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17113 - RNA, 9876 nt, Artificial Sequence
  derived and/or modified CDS sequence (opt4) from DENV-2__KF955369__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccaccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17114 - RNA, 9876 nt, Artificial Sequence
  derived and/or modified CDS sequence (opt4) from DENV-2__EU569702__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagagagccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacagcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17115 - RNA, 9876 nt, Artificial Sequence
  derived and/or modified CDS sequence (opt4) from DENV-2__EU482624__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccaacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacauccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17116 - RNA, 9876 nt, Artificial Sequence
  derived and/or modified CDS sequence (opt4) from DENV-2__EU596500__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagauggugauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagagcaucggcaagaugacccugggcaugugcugcaucaucaccgccagcauccugcuguggcacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccuguucgccaucggcugcuacuaccaggugaaccccaucacccugaccgccgcccugcugcugcugguggcccacaacgccaucaucggccagggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17117 - RNA, 9876 nt, Artificial Sequence
  derived and/or modified CDS sequence (opt4) from DENV-2__EU482626__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacauccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccacccagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17118 - RNA, 9876 nt, Artificial Sequence
  derived and/or modified CDS sequence (opt4) from DENV-2__EU482629__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucaaggaccugggcagagugauggugaugaugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaagaucagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17119 - RNA, 9876 nt, Artificial Sequence
  derived and/or modified CDS sequence (opt4) from DENV-2__FJ390390__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccaaguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagacaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccugcugcuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccgugauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17120 - RNA, 9876 nt, Artificial Sequence
  derived and/or modified CDS sequence (opt4) from DENV-2__FJ390391__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccaucuucgagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17121 - RNA, 9876 nt, Artificial Sequence
  derived and/or modified CDS sequence (opt4) from DENV-2__FJ882593__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17122 - RNA, 9876 nt, Artificial Sequence
  derived and/or modified CDS sequence (opt4) from DENV-2__FJ182014__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugccccuuccugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaucaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17123 - RNA, 9876 nt, Artificial Sequence
  derived and/or modified CDS sequence (opt4) from DENV-2__FJ547090__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccaccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacugggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17124 - RNA, 9876 nt, Artificial Sequence
  derived and/or modified CDS sequence (opt4) from DENV-2__EU482630__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugccccuuccugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17125 - RNA, 9876 nt, Artificial Sequence
  derived and/or modified CDS sequence (opt4) from DENV-2__FJ882594__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaacauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgaggccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17126 - RNA, 9876 nt, Artificial Sequence
  derived and/or modified CDS sequence (opt4) from DENV-2__FJ205885__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcgugcugaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacaccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17127 - RNA, 9876 nt, Artificial Sequence
  derived and/or modified CDS sequence (opt4) from DENV-2__FJ744743__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccuguggccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcgugaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccacccugcugagauucguggcccaguacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaucgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17128 - RNA, 9876 nt, Artificial Sequence
  derived and/or modified CDS sequence (opt4) from DENV-2__JN819424__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccagcagcaucgacaacagagccgugcacgccgacaugggcuacuggauggagagcgcccccagcgacagcugcaagauggagaaggccagcuucaucgaggacaagagcugcuacuggcccaacagccagcaccuguggagcaacggcgugcuggagagcgagaugaucuuccccaagaacuucgccggccccgugagccagcacaucuacagacccggcuaccacacccagaccgccggccccugcaaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggaggccaucgacggcgaguacagacugagaggcgaggccagaaagaccuucguggaccugaugagaagaggcgaccugcccgugagacuggccuacaagguggccgccgagggcaucaacuacgccgacagaaaguggugcuucgacggcaucaagaacagccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17129 - RNA, 9876 nt, Artificial Sequence
  derived and/or modified CDS sequence (opt4) from DENV-2__FJ744741__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggagagugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17130 - RNA, 9876 nt, Artificial Sequence
  derived and/or modified CDS sequence (opt4) from DENV-2__FJ744703__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaaccgacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccccagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17131 - RNA, 9876 nt, Artificial Sequence
  derived and/or modified CDS sequence (opt4) from DENV-2__FJ850067__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccacccuggugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaccaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgagacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaagaucagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17132 - RNA, 9876 nt, Artificial Sequence
  derived and/or modified CDS sequence (opt4) from DENV-2__FJ850060__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaagaucagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcgccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucagaaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcaagcugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccagggcaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17133 - RNA, 9876 nt, Artificial Sequence
  derived and/or modified CDS sequence (opt4) from DENV-2__FJ850061__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgccaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaagcccaucaccuucaccgccgcccugcugcugcugguggcccacuacgccaucaucggccccggccugcaggccaaggcccccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17134 - RNA, 9876 nt, Artificial Sequence
  derived and/or modified CDS sequence (opt4) from DENV-2__FJ744709__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccgugcuggccuacaccaucggcaccacccacuuccagaaggcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcaucuuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacaccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcagaaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17135 - RNA, 9876 nt, Artificial Sequence
  derived and/or modified CDS sequence (opt4) from DENV-2__FJ744708__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgccgagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggugaacaucuucagcggcagcuaccuggccggcgccggccugcacgugccccugagaaagaacacccugagaaccagaagaggcaccggcaacaccggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17136 - RNA, 9876 nt, Artificial Sequence
  derived and/or modified CDS sequence (opt4) from DENV-2__FJ810418__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucaagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagauggugauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagaguggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17137 - RNA, 9876 nt, Artificial Sequence
  derived and/or modified CDS sequence (opt4) from DENV-2__FJ639835__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagauggugauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagagcaucggcaagaugacccugggcaugugcugcaucaucaccgccagcauccugcuguggcacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17138 - RNA, 9876 nt, Artificial Sequence
  derived and/or modified CDS sequence (opt4) from DENV-2__FJ850050__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcggcaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaguacaacagagccgugcacgccgacaugggcuacuggaucgagagcgcccccugcgacagcugggagaugcagaaggccagcuucaucgaggugaucagcugccacuggcccaagagccugacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacaugcaggagcagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17139 - RNA, 9876 nt, Artificial Sequence
  derived and/or modified CDS sequence (opt4) from DENV-2__FJ639837__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagauggugauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagagcaucggcaagaugacccugggcaugugcugcaucaucaccgccagcauccugcuguggcacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggcccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacguggccaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17140 - RNA, 9876 nt, Artificial Sequence
  derived and/or modified CDS sequence (opt4) from DENV-2__FJ744706__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccggcagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaggcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17141 - RNA, 9876 nt, Artificial Sequence
  derived and/or modified CDS sequence (opt4) from DENV-2__FJ744707__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggcccccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17142 - RNA, 9876 nt, Artificial Sequence
  derived and/or modified CDS sequence (opt4) from DENV-2__FJ744704__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcauguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaucugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17143 - RNA, 9876 nt, Artificial Sequence
  derived and/or modified CDS sequence (opt4) from DENV-2__FJ744745__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugaagauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcacccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17144 - RNA, 9876 nt, Artificial Sequence
  derived and/or modified CDS sequence (opt4) from DENV-2__FJ744705__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacgacagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccguggagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17145 - RNA, 9876 nt, Artificial Sequence
  derived and/or modified CDS sequence (opt4) from DENV-2__FJ744744__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugaagauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgugggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgagaacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17146 - RNA, 9876 nt, Artificial Sequence
  derived and/or modified CDS sequence (opt4) from DENV-2__GQ868646__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccaaguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagacaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccugcugcuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccgugauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17147 - RNA, 9876 nt, Artificial Sequence
  derived and/or modified CDS sequence (opt4) from DENV-2__FJ906961__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugagagagaagcaggagguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17148 - RNA, 9876 nt, Artificial Sequence
  derived and/or modified CDS sequence (opt4) from DENV-2__FJ906962__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgagaucaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaacauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaucgaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17149 - RNA, 9876 nt, Artificial Sequence
  derived and/or modified CDS sequence (opt4) from DENV-2__FJ850053__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17150 - RNA, 9876 nt, Artificial Sequence
  derived and/or modified CDS sequence (opt4) from DENV-2__JN819420__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagagagccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacagcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaugggcugcuacagccaguucaagcccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17151 - RNA, 9876 nt, Artificial Sequence
  derived and/or modified CDS sequence (opt4) from DENV-2__FJ850118__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggcuacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17152 - RNA, 9876 nt, Artificial Sequence
  derived and/or modified CDS sequence (opt4) from DENV-2__JN819416__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17153 - RNA, 9876 nt, Artificial Sequence
  derived and/or modified CDS sequence (opt4) from DENV-2__FJ850119__SS-prME
accgccggcgugaucgugaugcugauccccaccgccauggccuuccaccugaccaccagaaacggcgagccccacaugaucgugggcagacaggagaagggcaagagccugcuguucaagaccgaggacggcaucaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccagcgaggagaccgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17154 - RNA, 9876 nt, Artificial Sequence
  derived and/or modified CDS sequence (opt4) from DENV-2__FJ850064__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgccaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17155 - RNA, 9876 nt, Artificial Sequence
  derived and/or modified CDS sequence (opt4) from DENV-2__FJ850065__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaccgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggaggacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaagcacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17156 - RNA, 9876 nt, Artificial Sequence
  derived and/or modified CDS sequence (opt4) from DENV-2__FJ873808__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaagaucagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcgccauccuggccgccgugagcgugagcccccugcugcugaccagcagcaagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucagaaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcaagcugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccagggcaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17157 - RNA, 9876 nt, Artificial Sequence
  derived and/or modified CDS sequence (opt4) from DENV-2__FJ850120__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcgugaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccaagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagaacaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcagcaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17158 - RNA, 9876 nt, Artificial Sequence
  derived and/or modified CDS sequence (opt4) from DENV-2__FJ850121__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgugacccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17159 - RNA, 9876 nt, Artificial Sequence
  derived and/or modified CDS sequence (opt4) from DENV-2__GQ199897__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcugguggugagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17160 - RNA, 9876 nt, Artificial Sequence
  derived and/or modified CDS sequence (opt4) from DENV-2__GQ199895__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggaggacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17161 - RNA, 9876 nt, Artificial Sequence
  derived and/or modified CDS sequence (opt4) from DENV-2__FJ898478__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17162 - RNA, 9876 nt, Artificial Sequence
  derived and/or modified CDS sequence (opt4) from DENV-2__GQ199869__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacauccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17163 - RNA, 9876 nt, Artificial Sequence
  derived and/or modified CDS sequence (opt4) from DENV-2__JX079688__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcuguggcacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaucgaggaguacaccgacuacaugcccagcaugaagagauucagaagagaggaggaggaggccggcgugcugugguga

SEQ ID NO: 17164 - RNA, 9876 nt, Artificial Sequence
  derived and/or modified CDS sequence (opt4) from DENV-2__JF357906__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccgugcuggccuacaccaucggcaccacccacuuccagaaggcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcaucuuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacaccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcagaaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccugguacauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17165 - RNA, 9873 nt, Artificial Sequence
  derived and/or modified CDS sequence (opt4) from DENV-2__HQ705624__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccaaguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaaggugcccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccaucaagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagacaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccugcugcuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccgugauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuuccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17166 - RNA, 9876 nt, Artificial Sequence
  derived and/or modified CDS sequence (opt4) from DENV-2__HQ705625__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaugaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaccaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17167 - RNA, 9876 nt, Artificial Sequence
  derived and/or modified CDS sequence (opt4) from DENV-2__JF730052__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaugaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaccaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaccaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17168 - RNA, 9876 nt, Artificial Sequence
  derived and/or modified CDS sequence (opt4) from DENV-2__EU482748__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggagaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaagaccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucguggugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17169 - RNA, 9876 nt, Artificial Sequence
  derived and/or modified CDS sequence (opt4) from DENV-2__EU482749__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagaccaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugagcgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaagaucagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17170 - RNA, 9876 nt, Artificial Sequence
  derived and/or modified CDS sequence (opt4) from DENV-2__EU482751__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17171 - RNA, 9876 nt, Artificial Sequence
  derived and/or modified CDS sequence (opt4) from DENV-2__GQ868604__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggcagaggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaacauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17172 - RNA, 9876 nt, Artificial Sequence
  derived and/or modified CDS sequence (opt4) from DENV-2__EU482752__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaacauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17173 - RNA, 9876 nt, Artificial Sequence
  derived and/or modified CDS sequence (opt4) from DENV-2__EU482753__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagcaugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17174 - RNA, 9876 nt, Artificial Sequence
  derived and/or modified CDS sequence (opt4) from DENV-2__EU482680__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaccggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagaagcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17175 - RNA, 9876 nt, Artificial Sequence
  derived and/or modified CDS sequence (opt4) from DENV-2__EU482754__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacauccacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17176 - RNA, 9876 nt, Artificial Sequence
  derived and/or modified CDS sequence (opt4) from DENV-2__FJ478455__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccguggagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17177 - RNA, 9876 nt, Artificial Sequence
  derived and/or modified CDS sequence (opt4) from DENV-2__EU482756__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaaguacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17178 - RNA, 9876 nt, Artificial Sequence
  derived and/or modified CDS sequence (opt4) from DENV-2__EU482757__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucguggugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17179 - RNA, 9876 nt, Artificial Sequence
  derived and/or modified CDS sequence (opt4) from DENV-2__FJ906956__SS-prME
accgccggcgugaucgugaugcugauccccaccgccauggccuuccaccugaccaccagaaacggcgagccccacaugaucgugggcaagcaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagauggugauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagagagugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaaccacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17180 - RNA, 9876 nt, Artificial Sequence
  derived and/or modified CDS sequence (opt4) from DENV-2__EU482759__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagaggcgccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17181 - RNA, 9876 nt, Artificial Sequence
  derived and/or modified CDS sequence (opt4) from DENV-2__EU482760__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcgccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaagaucagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17182 - RNA, 9876 nt, Artificial Sequence
  derived and/or modified CDS sequence (opt4) from DENV-2__EU482762__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugcuacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17183 - RNA, 9876 nt, Artificial Sequence
  derived and/or modified CDS sequence (opt4) from DENV-2__EU482763__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacaccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17184 - RNA, 9876 nt, Artificial Sequence
  derived and/or modified CDS sequence (opt4) from DENV-2__EU482444__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccauccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgugauguacgccgacgacaccgccggcugggacaccagaaucacccuggaggaccugaagaacgaggagcuggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17185 - RNA, 9876 nt, Artificial Sequence
  derived and/or modified CDS sequence (opt4) from DENV-2__EU482684__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccaccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17186 - RNA, 9876 nt, Artificial Sequence
  derived and/or modified CDS sequence (opt4) from DENV-2__EU482685__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggcaacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagacaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17187 - RNA, 9876 nt, Artificial Sequence
  derived and/or modified CDS sequence (opt4) from DENV-2__EU482687__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccgugcuggccuacaccaucggcaccacccacuuccagagagcccugaucuucgugcugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaugaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17188 - RNA, 9876 nt, Artificial Sequence
  derived and/or modified CDS sequence (opt4) from DENV-2__EU482688__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagccuggugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcaucgacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagcaugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17189 - RNA, 9876 nt, Artificial Sequence
  derived and/or modified CDS sequence (opt4) from DENV-2__EU482691__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaucaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacaccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17190 - RNA, 9876 nt, Artificial Sequence
  derived and/or modified CDS sequence (opt4) from DENV-2__EU482693__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccacccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccgccgaggagaacguggugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17191 - RNA, 9876 nt, Artificial Sequence
  derived and/or modified CDS sequence (opt4) from DENV-2__EU596483__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggauggagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacaccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggagaccggcgugcugugguga

SEQ ID NO: 17192 - RNA, 9876 nt, Artificial Sequence
  derived and/or modified CDS sequence (opt4) from DENV-2__EU482597__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugagcgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaagaucagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17193 - RNA, 9876 nt, Artificial Sequence
  derived and/or modified CDS sequence (opt4) from DENV-2__EU482598__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17194 - RNA, 9876 nt, Artificial Sequence
  derived and/or modified CDS sequence (opt4) from DENV-2__EU482603__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgccgagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagagacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaagaccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucguggugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17195 - RNA, 9876 nt, Artificial Sequence
  derived and/or modified CDS sequence (opt4) from DENV-2__EU482599__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggugaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17196 - RNA, 9876 nt, Artificial Sequence
  derived and/or modified CDS sequence (opt4) from DENV-2__FJ898436__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgccuggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17197 - RNA, 9876 nt, Artificial Sequence
  derived and/or modified CDS sequence (opt4) from DENV-2__EU482634__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacaccaaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucguggugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17198 - RNA, 9876 nt, Artificial Sequence
  derived and/or modified CDS sequence (opt4) from DENV-2__EU482635__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugagcgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17199 - RNA, 9876 nt, Artificial Sequence
  derived and/or modified CDS sequence (opt4) from DENV-2__GQ199874__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17200 - RNA, 9876 nt, Artificial Sequence
  derived and/or modified CDS sequence (opt4) from DENV-2__EU482639__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccacccuggugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgagacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaagaucagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17201 - RNA, 9876 nt, Artificial Sequence
  derived and/or modified CDS sequence (opt4) from DENV-2__EU482766__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagcagcagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagacaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17202 - RNA, 9876 nt, Artificial Sequence
  derived and/or modified CDS sequence (opt4) from DENV-2__EU482695__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17203 - RNA, 9876 nt, Artificial Sequence
  derived and/or modified CDS sequence (opt4) from DENV-2__EU482769__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagaccaccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagcaugaucggccugaccagcagagccaccugggccaagaacauccagaccgccaucaaccaggugagaagccugaucggcaacgaggaguacaucgacuacaugcccagcaugaagagauucagaagagaggaggaggaggccggcgugcugugguga

SEQ ID NO: 17204 - RNA, 9876 nt, Artificial Sequence
  derived and/or modified CDS sequence (opt4) from DENV-2__EU482696__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggccagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccacccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaccuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaucgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccgccgaggagaucguggugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17205 - RNA, 9876 nt, Artificial Sequence
  derived and/or modified CDS sequence (opt4) from DENV-2__KC294207__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacugcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccggccaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucgugggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggugguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17206 - RNA, 9876 nt, Artificial Sequence
  derived and/or modified CDS sequence (opt4) from DENV-2__KC294208__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcgaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucgugggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggugguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17207 - RNA, 9876 nt, Artificial Sequence
  derived and/or modified CDS sequence (opt4) from DENV-2__KC294209__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucgugggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggugguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17208 - RNA, 9876 nt, Artificial Sequence
  derived and/or modified CDS sequence (opt4) from DENV-2__KC294214__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggagaaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucgugggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccaccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggugguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17209 - RNA, 9876 nt, Artificial Sequence
  derived and/or modified CDS sequence (opt4) from DENV-2__KC294205__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccaccagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaccaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucgugggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggugguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17210 - RNA, 9876 nt, Artificial Sequence
  derived and/or modified CDS sequence (opt4) from DENV-2__KC294210__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaugauggagagcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucgugggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggugagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggugguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17211 - RNA, 9876 nt, Artificial Sequence
  derived and/or modified CDS sequence (opt4) from DENV-2__KC294215__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucgugggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccaaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggugguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17212 - RNA, 9876 nt, Artificial Sequence
  derived and/or modified CDS sequence (opt4) from DENV-2__KC294216__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggaccuggagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcgaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuuccugacccugaucaccggcaacaugagcuucagagaccugggcagagugauggugauggugggcguggccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccacccccgagaccauccuggagcugaccgacgcccuggcccugggcaugauggugcugaagaucgugagaaacauggagaaguaccagcuggccgugaccaucaugaccaucagcugcgugcccaacgccaugauccugaucaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugagaaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagagagaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggccaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccguguucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17213 - RNA, 9876 nt, Artificial Sequence
  derived and/or modified CDS sequence (opt4) from DENV-2__KC294218__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugauccugauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucgugggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggugguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17214 - RNA, 9876 nt, Artificial Sequence
  derived and/or modified CDS sequence (opt4) from DENV-2__KC294220__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaugugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucgugggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggugguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17215 - RNA, 9876 nt, Artificial Sequence
  derived and/or modified CDS sequence (opt4) from DENV-2__KC294221__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagagaggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucgugggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggugguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17216 - RNA, 9876 nt, Artificial Sequence
  derived and/or modified CDS sequence (opt4) from DENV-2__KC294223__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucgugggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggugguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17217 - RNA, 9876 nt, Artificial Sequence
  derived and/or modified CDS sequence (opt4) from DENV-2__FJ906959__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugccccuuccugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacaugaagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagaugaucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaucaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugcagccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaagauggagaaguaccagcuggccgugaccaucauggccauccugugcgugcccaacgccgugauccugcagaacgccuggaaggugagcugcaccauccuggccguggugagcgugagcccccuguuccugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggagcagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17218 - RNA, 9876 nt, Artificial Sequence
  derived and/or modified CDS sequence (opt4) from DENV-2__KF360005__SS-prME
accgccggcgugaucaucaugagaauccccaccgccauggccuuccaccugaccaccagaaacggcgagccccacaugaucgugagcaagcaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcauggugggcagaggcuggggcgacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacauccagggcagcaacuggauccagaaggagacccuggugaccuucaagaacccccacgccaagaagcaggacgugguggugcugggcagccaggagggcgcccugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagaauccaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggagaaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugagcaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccacccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgaggugagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugagcgccgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcagaaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcgccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccgccgacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcagccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugagaggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcguggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucgccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaucggcgaguucggcaaggccaagggcagcagagccgugugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaagcagcggccaggugggcaccuacggccugaacaccuucaccaacaugggcgcccagcugaucagacagauggagggcgagggcguguucaagggcauccagcaccugaccgccaccgaggagguggccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagaggccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagaggcgaccaguggugcggcagccugaucggccugaccagcagagccaccugggccagaaacauccagaccgccaucaacagagugagaagccugaucggcagcgagggcuacaccgacuacaugcccagcaugaagagauucagaagagaggaggacgaggccggcgugcugugguga

SEQ ID NO: 17219 - RNA, 9876 nt, Artificial Sequence
  derived and/or modified CDS sequence (opt4) from DENV-2__KJ010185__SS-prME
accgccggcgugaucaucaugcugauccccaccgccauggccuuccaccugaccaccagaaacggcgagccccacaugaucgugagcaagcaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacgccaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacauccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaacccccuguucaccggccaccugaagugcagacugagaauggacaagcugcagcugaagggcaugagcuacagcaugugcaccggcaaguucaagguggugaaggagaucgccgagacccagcacggcaccaucguggugagaauccaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucuucaccgacaacgugcacaccuggaccgagcaguacaaguuccagcccgagagccccagcaagcuggccagcgccauccagaaggcccacgaggagggcaucugcggcaucagaagcaucaccagacuggacaaccugauguggaagcagaucacccccgagcugaaccacauccugagcgagaacgaggugaagcugagcaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgcccagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccacccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccagcagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagagugagccugcugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcugaccggcgccgacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgaccccgacguggaccugggcagcggcaccagaaacaucggcaucgagagcgagacccccaaccuggacaucaucggcaagagaaucgagaagaucaagcaggagcacgagaccagcagacacuacgaccaggaccaccccuacaagaccugggccuaccacggcagcuacgagaccaagcagaccggcagcgccagcagcaccgugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucgccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaucggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcgugcaggugggcaccuacggccugggcaccuucaccaacaugggcgcccagcugaucagacagauggagggcgagggcguguucaagggcauccagcaccugaccgccaccgaggagguggccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccggccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccagaaacauccagaccgccaucaaccaggugagaagccugaucggcagcgaggaguacaccgacuacaugcccagcaugaagagauucggcagagaggaggaggaggccggcgugcugugguga

SEQ ID NO: 17220 - RNA, 9876 nt, Artificial Sequence
  derived and/or modified CDS sequence (opt4) from DENV-2__KJ010186__SS-prME
accgccggcgugaucaucaugcugauccccaccgccauggccuuccaccugaccaccagaaacggcgagccccacaugaucgugagcaagcaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacgccaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccagacugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacauccagggcagcaacuggauccagaaggagacccuggugaccuucaagaagccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaccgcccugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugagcaucaugaccggcgacaucaagggcauccugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccacccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugagaagcuacccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucgccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaucggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagggcauccagcaccugaccgccaccgaggagguggccgugcaggacuggcuggccagagugggcagagagagacugagcagaauggccaucagcggcgacgacugcguggugaagccccuggacgacagauucgccaacgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccagaaacauccagaccgccaucaaccaggugagaagccugaucggcagcgaggaguacaccgacuacaugcccagcaugaagagauucagaagagaggaggaggaggccggcgugcugugguga

SEQ ID NO: 17221 - RNA, 9876 nt, Artificial Sequence
  derived and/or modified CDS sequence (opt4) from DENV-2__KF955364__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacggcgugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacgugcugugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaaguacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17222 - RNA, 9876 nt, Artificial Sequence
  derived and/or modified CDS sequence (opt4) from DENV-2__KF955372__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggaguacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacguggaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaccgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17223 - RNA, 9876 nt, Artificial Sequence
  derived and/or modified CDS sequence (opt4) from DENV-2__KF955373__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguucccccugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17224 - RNA, 9876 nt, Artificial Sequence
  derived and/or modified CDS sequence (opt4) from DENV-2__GQ868600__SS-prME
accgccggcaugaucaucaugcugauccccaccgugauggccuuccaccugaccaccagaaacggcgagccccacaugaucgugagcagacaggagaagggcaagagccugcuguucaagaccaaggacggcaccaacaugugcacccugauggccauggaccugggcgagcugugcgaggacaccaucaccuacaagugccccuuccugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccaucgcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccacccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccguggugaucaccccccacagcggcgaggagcacgccgugggcaacgacaccggcaagcacggcaaggaggugaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcuggacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucaccagcgagcugaaccacauccugagcgagaacgaggugaagcugaccaucaugaccggcgacaucaagggcaucaugcaggugggcaagagaagccugagaccccagcccaccgagcugagauacagcuggaagaccuggggcaaggccaagaugcugagcaccgagcugcacaaccagaccuuccugaucgacggccccgagaccgccgagugccccaacaccaacagagccuggaacagccuggagguggaggacuacggcuucggcguguucaccaccaacaucuggcugagacugagagagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagauggugauccccaagaacuucgccggccccgugagccagcacaacaacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugagcagccuggugaccgccggccacggccagaucgacaacuucagccugggcauccugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcagcauccccgagaccauccuggagcugaccgacgcccuggcccugggcaugauggugcugaagauggugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggacgaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucagaaccaacaccggcaccaucggcgccgugagccuggacuucagccccggcaccagcggcagccccaucguggacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaagaccggcaacgacaucgccgccugccugagaaagaacggcaagagagugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccagaaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaccagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacgugaucaucgccauccugaccgugguggccgccaccauggccaacgagaugggcuuccuggagaagaccaagaaggaccugggccugggcaacaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccgugagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucgugccccccgagaagugcgacacccugcugugcgacaucggcgagagcagccccaaccccaccguggaggccggcagaacccugagagugcugaaccugguggagaacuggcugaacaacaacacccaguucugcgugaaggugcugaaccccuacaugcccagcgugaucgagagaauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucaccaucgaggaccugaagaacgaggagaugaucaccaaccacauggccggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccagcgaggagaucgccgugcaggacuggcuggugagagugggcagagagagacugagcagaauggccaucagcggcgacgacugcguggugaagccccuggacgacagauucgccagagcccugaccgcccugaacgacaugggcaaggugagaaaggacauccagcagugggagcccagcagaggcuggaacgacuggacccaggugcccuucugcagccaccacuuccacgagcugaucaugaaggacggcagaacccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagccacgaguggaugaccaccgaggacaugcugaccguguggaacaagguguggauccuggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17225 - RNA, 9876 nt, Artificial Sequence
  derived and/or modified CDS sequence (opt4) from DENV-2__KF955359__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaccauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccauccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgccagccuggugcuggugggcaucgugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagaaggccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagaaugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17226 - RNA, 9876 nt, Artificial Sequence
  derived and/or modified CDS sequence (opt4) from DENV-2__KF955360__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcgccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17227 - RNA, 9876 nt, Artificial Sequence
  derived and/or modified CDS sequence (opt4) from DENV-2__KF955363__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauuccugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcaggugacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggugaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17228 - RNA, 9876 nt, Artificial Sequence
  derived and/or modified CDS sequence (opt4) from DENV-2__EU726767__SS-prME
agcgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcgccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacgugaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucaugacccugaucaccggcaacaugagcuucaaggaccugggcagagugguggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgcccugcugagccagagcaccauccccgagaccauccuggagcugaccgacgcccuggcccugggcaugauggugcugaagauggugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgugacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccguguucaccgacgagaacaaguggaagagcgccagagaggccguggaggacagcagauucugggagcugguggacaaggagagaagccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17229 - RNA, 9876 nt, Artificial Sequence
  derived and/or modified CDS sequence (opt4) from DENV-2__EU687246__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggcccugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaacauccccgagaccauccuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgacaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugaucgcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcagcgaggaguacaccgacuacaugcccagcaugaagagauucagaagagaggaggaggaggccggcgugcugugguga

SEQ ID NO: 17230 - RNA, 9876 nt, Artificial Sequence
  derived and/or modified CDS sequence (opt4) from DENV-2__FJ639828__SS-prME
agcgugggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagaacccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgccaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccuguuccugagaaagcugaccagcaaggagcugaugaugaccaccaucggcaucgugcugcugagccagagcacccugcccgagaccauccuggagcugaccgacgcccuggcccugggcaugauggugcugaagauggugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagagaggcauccugggcuacagccagaucggcgccggcguguacaaggagggcaccuuccacaccauguggcacgugaccagaggcgccgugcugacccacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgacaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucgugaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgccccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacagcagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17231 - RNA, 9876 nt, Artificial Sequence
  derived and/or modified CDS sequence (opt4) from DENV-2__FJ639829__SS-prME
agcgugggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagaacccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccuguuccugagaaagcugaccagcaaggagcugaugaugaccaccaucggcaucgugcugcugagccagagcaccauccccgagaccauccuggagcugaccgacgcccuggcccugggcaugauggugcugaagauggugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagagaggcauccugggcuacagccagaucggcgccggcguguacaaggagggcaccuuccacaccauguggcacgugaccagaggcgccgugcugacccacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgacaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucgugaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgccccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacagcagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagguggccaucaaccaggugagaagccugaucggcaacgaggaguacaccgacuacaugcccagcaugaagagauucagaagagaggaggaggaggccggcgugcugugguga

SEQ ID NO: 17232 - RNA, 9876 nt, Artificial Sequence
  derived and/or modified CDS sequence (opt4) from DENV-2__FJ639831__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaucguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcgugaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucguggccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcgugcugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgacaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggccaugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaagaccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaagcugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugaucuacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17233 - RNA, 9876 nt, Artificial Sequence
  derived and/or modified CDS sequence (opt4) from DENV-2__FJ639832__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17234 - RNA, 9876 nt, Artificial Sequence
  derived and/or modified CDS sequence (opt4) from DENV-2__FJ687434__SS-prME
agcgugggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagaacccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccagacugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccagccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgacaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucgugaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgccccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggccaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacagcagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17235 - RNA, 9876 nt, Artificial Sequence
  derived and/or modified CDS sequence (opt4) from DENV-2__FJ687439__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgccaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacaucagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17236 - RNA, 9876 nt, Artificial Sequence
  derived and/or modified CDS sequence (opt4) from DENV-2__FJ687440__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccuggaucaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaccggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagaucgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17237 - RNA, 9876 nt, Artificial Sequence
  derived and/or modified CDS sequence (opt4) from DENV-2__FJ687441__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccuggaucaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagaucgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17238 - RNA, 9876 nt, Artificial Sequence
  derived and/or modified CDS sequence (opt4) from DENV-2__FJ687445__SS-prME
agcgugggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagaacccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccuguuccugagaaagcugaccagcaaggagcugaugaugaccaccaucggcaucgugcugcugagccagagcaccauccccgagaccauccuggagcugaccgacgcccuggcccugggcaugauggugcugaagauggugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagagaggcauccugggcuacagccagaucggcgccggcguguacaaggagggcaccuuccacaccauguggcacgugaccagaggcgccgugcugacccacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgacaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucgugaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgccccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccaucccccacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacagcagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagguggccaucaaccaggugagaagccugaucggcaacgaggaguacaccgacuacaugcccagcaugaagagauucagaagagaggaggaggaggccggcgugcugugguga

SEQ ID NO: 17239 - RNA, 9876 nt, Artificial Sequence
  derived and/or modified CDS sequence (opt4) from DENV-2__FJ687447__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccagccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaucggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuucaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17240 - RNA, 9876 nt, Artificial Sequence
  derived and/or modified CDS sequence (opt4) from DENV-2__FJ810411__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccagccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaucggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuucaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17241 - RNA, 9876 nt, Artificial Sequence
  derived and/or modified CDS sequence (opt4) from DENV-2__FJ744713__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccagccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagauccugaccauccugaucagaaccggccugcuggugaucagcggccuguuccccaucagcauccccaucaccgccgccgccugguaccugugggaggugaagaagcagagagccggcgugcugugggacgugcccagccccccccccaucggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuucaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17242 - RNA, 9876 nt, Artificial Sequence
  derived and/or modified CDS sequence (opt4) from DENV-2__FJ744714__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagagaauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17243 - RNA, 9876 nt, Artificial Sequence
  derived and/or modified CDS sequence (opt4) from DENV-2__FJ744716__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagagaauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugagaaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17244 - RNA, 9876 nt, Artificial Sequence
  derived and/or modified CDS sequence (opt4) from DENV-2__FJ744718__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcagccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17245 - RNA, 9876 nt, Artificial Sequence
  derived and/or modified CDS sequence (opt4) from DENV-2__FJ744722__SS-prME
agcgugggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagaacccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccaaccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccuguuccugagaaagcugaccagcaaggagcugaugaugaccaccaucggcaucgugcugcugagccagagcaccauccccgagaccauccuggagcugaccgacgcccuggcccugggcaugauggugcugaagauggugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagagaggcauccugggcuacagccagaucggcgccggcguguacaaggagggcaccuuccacaccauguggcacgugaccagaggcgccgugcugacccacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgacaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucgugaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgccccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacagcagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagguggccaucaaccaggugagaagccugaucggcaacgaggaguacaccgacuacaugcccagcaugaagagauucagaagagaggaggaggaggccggcgugcugugguga

SEQ ID NO: 17246 - RNA, 9876 nt, Artificial Sequence
  derived and/or modified CDS sequence (opt4) from DENV-2__FJ744723__SS-prME
agcgugggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagaacccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccuguuccugagaaagcugaccagcaaggagcugaugaugaccaccaucggcaucgugcugcugagccagagcaccauccccgagaccauccuggagcugaccgacgcccuggcccugggcaugauggugcugaagauggugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagagaggcauccugggcuacagccagaucggcgccggcguguacaaggagggcaccuuccacaccauguggcacgugaccagaggcgccgugcugacccacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgacaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucgugaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgccccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacagcagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaccgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagguggccaucaaccaggugagaagccugaucggcaacgaggaguacaccgacuacaugcccagcaugaagagauucagaagagaggaggaggaggccggcgugcugugguga

SEQ ID NO: 17247 - RNA, 9876 nt, Artificial Sequence
  derived and/or modified CDS sequence (opt4) from DENV-2__FJ744724__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaucguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcgugaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17248 - RNA, 9876 nt, Artificial Sequence
  derived and/or modified CDS sequence (opt4) from DENV-2__FJ906957__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgccagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17249 - RNA, 9876 nt, Artificial Sequence
  derived and/or modified CDS sequence (opt4) from DENV-2__FJ906958__SS-prME
agcgugggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaaggugcccuucgagaucauggaccuggagaagagauacgugcugggcagacugaucaccgugaaccccguggugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccgugaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccagggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgacaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgccaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucgugaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagagacuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17250 - RNA, 9876 nt, Artificial Sequence
  derived and/or modified CDS sequence (opt4) from DENV-2__FJ898452__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17251 - RNA, 9876 nt, Artificial Sequence
  derived and/or modified CDS sequence (opt4) from DENV-2__GQ868591__SS-prME
agcgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugaccaugagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugacccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucaccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagauacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucgccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccaucaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17252 - RNA, 9876 nt, Artificial Sequence
  derived and/or modified CDS sequence (opt4) from DENV-2__GQ868542__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcggcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcaccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggacagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17253 - RNA, 9876 nt, Artificial Sequence
  derived and/or modified CDS sequence (opt4) from DENV-2__GQ868544__SS-prME
agcgugggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaaggugcccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccagggccagaucgacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgacaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucgugaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccuguacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17254 - RNA, 9876 nt, Artificial Sequence
  derived and/or modified CDS sequence (opt4) from DENV-2__GQ868545__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaucguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcgugaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccacccuggccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagagacauggagaaguaccagcuggccgugaccaucauggccacccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgacaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaagcugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17255 - RNA, 9876 nt, Artificial Sequence
  derived and/or modified CDS sequence (opt4) from DENV-2__GQ868543__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcauguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggugaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17256 - RNA, 9876 nt, Artificial Sequence
  derived and/or modified CDS sequence (opt4) from DENV-2__EU482544__SS-prME
accgccggcgugaucaucaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17257 - RNA, 9876 nt, Artificial Sequence
  derived and/or modified CDS sequence (opt4) from DENV-2__EU482545__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucaugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcgugggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggcccugaagaucgugaagaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucagaaacgaggaggaggagcagacccugaccauccugaucagaaccggccugcuggugaucagcggcguguuccccgugagcauccccgugaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccuggugagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17258 - RNA, 9876 nt, Artificial Sequence
  derived and/or modified CDS sequence (opt4) from DENV-2__EU482546__SS-prME
accgccggcgugaucgugaugcugauccccaccgugauggccuuccaccugaccaccagaaacggcgagccccacaugaucgugggcagacaggagaagggcaagagccugcuguucaagaccgaggacggcaucaacaugugcacccugauggccaucgaccugggcgagcugugcgaggacaccaucaccuacaagugcccccugcugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacgccuucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaaccacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcuuccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagagugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucagccaggugagaagccugaucggcaacgaggaguacaccgacuacaugcccagcaugaagagauucagaagagaggaggaggaggccggcgugcugugguga

SEQ ID NO: 17259 - RNA, 9876 nt, Artificial Sequence
  derived and/or modified CDS sequence (opt4) from DENV-2__EU482550__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaucacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaagccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccugguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17260 - RNA, 9876 nt, Artificial Sequence
  derived and/or modified CDS sequence (opt4) from DENV-2__EU482551__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaccauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagaaggccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagaaugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17261 - RNA, 9876 nt, Artificial Sequence
  derived and/or modified CDS sequence (opt4) from DENV-2__EU482552__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaccggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggcuacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17262 - RNA, 9876 nt, Artificial Sequence
  derived and/or modified CDS sequence (opt4) from DENV-2__EU482554__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaccguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaucacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaagccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccugguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17263 - RNA, 9876 nt, Artificial Sequence
  derived and/or modified CDS sequence (opt4) from DENV-2__EU482556__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggugagccacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccgugcugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccacccugaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggugagagugggcagagagagacugagcagaauggccgugagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17264 - RNA, 9876 nt, Artificial Sequence
  derived and/or modified CDS sequence (opt4) from DENV-2__EU529693__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaccauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagaaugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17265 - RNA, 9876 nt, Artificial Sequence
  derived and/or modified CDS sequence (opt4) from DENV-2__EU482557__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17266 - RNA, 9876 nt, Artificial Sequence
  derived and/or modified CDS sequence (opt4) from DENV-2__EU482560__SS-prME
accgccggcgugaucgugaugcugauccccaccgugauggccuuccaccugaccaccagaaacggcgagccccacaugaucgugggcagacaggagaagggcaagagccugcuguucaagaccgaggacggcaucaacaugugcacccugauggccaucgaccugggcgagcugugcgaggacaccaucaccuacaagugcccccugcugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacgccuucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaaccacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagccuggugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcuuccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgagaacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagagugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucagccaggugagaagccugaucggcaacgaggaguacaccgacuacaugcccagcaugaagagauucagaagagaggaggaggaggccggcgugcugugguga

SEQ ID NO: 17267 - RNA, 9876 nt, Artificial Sequence
  derived and/or modified CDS sequence (opt4) from DENV-2__EU482561__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccaugcugcuggugguggugagcuucgugacccugaucaccggcaacaugagcuucagagaccugggcagagugauggugauggugggcgccaccaugaccgacgacaucggcaugggcaucaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17268 - RNA, 9876 nt, Artificial Sequence
  derived and/or modified CDS sequence (opt4) from DENV-2__EU569703__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17269 - RNA, 9876 nt, Artificial Sequence
  derived and/or modified CDS sequence (opt4) from DENV-2__EU529694__SS-prME
accgccggcguguucaucaugcugauccccaccgccauggccuuccaccugaccaccagaaacggcgagccccacaugaucgugggcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccaugcugcugguggccgugagcuucgugacccugaucaccggcaacaugagcuucagagaccugggcagagugauggugauggugggcgccaccaugaccgacgacaucggcaugggcaucaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17270 - RNA, 9876 nt, Artificial Sequence
  derived and/or modified CDS sequence (opt4) from DENV-2__EU529695__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaucacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17271 - RNA, 9876 nt, Artificial Sequence
  derived and/or modified CDS sequence (opt4) from DENV-2__EU482562__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugauccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcuucauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17272 - RNA, 9876 nt, Artificial Sequence
  derived and/or modified CDS sequence (opt4) from DENV-2__EU482565__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacauccugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagcccccccaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacgugggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17273 - RNA, 9876 nt, Artificial Sequence
  derived and/or modified CDS sequence (opt4) from DENV-2__EU529700__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaaccuggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17274 - RNA, 9876 nt, Artificial Sequence
  derived and/or modified CDS sequence (opt4) from DENV-2__EU529701__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauuccugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcgugggcaaggcccugcaccagguguucggcgccaucuacggcgccgccuucagcggcgugagcuggaccaugaagaucuucaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17275 - RNA, 9876 nt, Artificial Sequence
  derived and/or modified CDS sequence (opt4) from DENV-2__EU569704__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauuccugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcauccugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17276 - RNA, 9876 nt, Artificial Sequence
  derived and/or modified CDS sequence (opt4) from DENV-2__EU482568__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauuccugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcauccugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaguggagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagaugugggcccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17277 - RNA, 9876 nt, Artificial Sequence
  derived and/or modified CDS sequence (opt4) from DENV-2__EU482569__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagaacgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugauccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17278 - RNA, 9876 nt, Artificial Sequence
  derived and/or modified CDS sequence (opt4) from DENV-2__EU482570__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauuccugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcaggugacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugggcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugaaggacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggugaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17279 - RNA, 9876 nt, Artificial Sequence
  derived and/or modified CDS sequence (opt4) from DENV-2__EU482571__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauuccugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgccuggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17280 - RNA, 9876 nt, Artificial Sequence
  derived and/or modified CDS sequence (opt4) from DENV-2__EU482572__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauuccugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcaggugacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccggcgacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugaugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgaggccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggugaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17281 - RNA, 9876 nt, Artificial Sequence
  derived and/or modified CDS sequence (opt4) from DENV-2__EU482573__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauuccugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17282 - RNA, 9876 nt, Artificial Sequence
  derived and/or modified CDS sequence (opt4) from DENV-2__EU482574__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauuccugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcacauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17283 - RNA, 9876 nt, Artificial Sequence
  derived and/or modified CDS sequence (opt4) from DENV-2__EU482575__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagagaagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauuccugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17284 - RNA, 9876 nt, Artificial Sequence
  derived and/or modified CDS sequence (opt4) from DENV-2__EU482578__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17285 - RNA, 9876 nt, Artificial Sequence
  derived and/or modified CDS sequence (opt4) from DENV-2__EU482580__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauuccugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagaucuucaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17286 - RNA, 9876 nt, Artificial Sequence
  derived and/or modified CDS sequence (opt4) from DENV-2__EU482581__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17287 - RNA, 9876 nt, Artificial Sequence
  derived and/or modified CDS sequence (opt4) from DENV-2__EU482582__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccaaccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccguguucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaccaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcaccgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17288 - RNA, 9876 nt, Artificial Sequence
  derived and/or modified CDS sequence (opt4) from DENV-2__EU482583__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacgccgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17289 - RNA, 9876 nt, Artificial Sequence
  derived and/or modified CDS sequence (opt4) from DENV-2__EU482585__SS-prME
accgccggcgugaucaucaugcugauccccaccgccaucgccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcggcaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagauggugauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacagcaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17290 - RNA, 9876 nt, Artificial Sequence
  derived and/or modified CDS sequence (opt4) from DENV-2__EU482587__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgagguggagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcagagagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaacagaaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagaucgugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17291 - RNA, 9876 nt, Artificial Sequence
  derived and/or modified CDS sequence (opt4) from DENV-2__EU482588__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaaggugcccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17292 - RNA, 9876 nt, Artificial Sequence
  derived and/or modified CDS sequence (opt4) from DENV-2__EU569705__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccaugcugcugguggccgugagcuucgugacccugaucaccggcaacaugagcuucagagaccugggcagagugauggugauggugggcgccaccaugaccgacgacaucggcaugggcaucaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucgugaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17293 - RNA, 9876 nt, Artificial Sequence
  derived and/or modified CDS sequence (opt4) from DENV-2__EU482589__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaugggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaaccuggccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcuggugaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17294 - RNA, 9876 nt, Artificial Sequence
  derived and/or modified CDS sequence (opt4) from DENV-2__EU569706__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaaccuggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17295 - RNA, 9876 nt, Artificial Sequence
  derived and/or modified CDS sequence (opt4) from DENV-2__EU569707__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcguggaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugagaauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccaugcugcugguggccgugagcuucgugacccugaucaccggcaacaugagcuucagagaccugggcagagugauggugauggugggcgccaccaugaccgacgacaucggcaugggcaucaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17296 - RNA, 9876 nt, Artificial Sequence
  derived and/or modified CDS sequence (opt4) from DENV-2__EU660399__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccaugcugcugguggccgugagcuucgugacccugaucaccggcaacaugagcuucagagaccugggcagagugauggugauggugggcgccaccaugaccgacgacaucggcaugggcaucaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagacagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagaaguaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17297 - RNA, 9876 nt, Artificial Sequence
  derived and/or modified CDS sequence (opt4) from DENV-2__EU569708__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaucaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcugaacgccuggaaggugagcugcaccauccuggccgccgugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcgugaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagagaaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccguguucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaagaaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17298 - RNA, 9876 nt, Artificial Sequence
  derived and/or modified CDS sequence (opt4) from DENV-2__EU569709__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaucacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17299 - RNA, 9876 nt, Artificial Sequence
  derived and/or modified CDS sequence (opt4) from DENV-2__EU596485__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgacagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaucacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucgccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17300 - RNA, 9876 nt, Artificial Sequence
  derived and/or modified CDS sequence (opt4) from DENV-2__EU569710__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaccuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccauccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaucacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17301 - RNA, 9876 nt, Artificial Sequence
  derived and/or modified CDS sequence (opt4) from DENV-2__EU596486__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaucacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaagccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaucgacuacaugcccagcaugaagagauucagaaaggaggaggaggaggccggcgugcugugguga

SEQ ID NO: 17302 - RNA, 9876 nt, Artificial Sequence
  derived and/or modified CDS sequence (opt4) from DENV-2__EU687212__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucaucaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccaugcccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccaccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccgugcccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17303 - RNA, 9876 nt, Artificial Sequence
  derived and/or modified CDS sequence (opt4) from DENV-2__EU660400__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccaccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagcagacagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17304 - RNA, 9876 nt, Artificial Sequence
  derived and/or modified CDS sequence (opt4) from DENV-2__EU569711__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacauccugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17305 - RNA, 9876 nt, Artificial Sequence
  derived and/or modified CDS sequence (opt4) from DENV-2__EU569712__SS-prME
accgccggcaugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaucacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugagaaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17306 - RNA, 9876 nt, Artificial Sequence
  derived and/or modified CDS sequence (opt4) from DENV-2__EU596487__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17307 - RNA, 9876 nt, Artificial Sequence
  derived and/or modified CDS sequence (opt4) from DENV-2__EU569713__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcagcgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggccaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaucacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuacaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggagaaggccggcgugcugugguga

SEQ ID NO: 17308 - RNA, 9876 nt, Artificial Sequence
  derived and/or modified CDS sequence (opt4) from DENV-2__EU569714__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgugauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaucacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17309 - RNA, 9876 nt, Artificial Sequence
  derived and/or modified CDS sequence (opt4) from DENV-2__EU569715__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccggcggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17310 - RNA, 9876 nt, Artificial Sequence
  derived and/or modified CDS sequence (opt4) from DENV-2__EU569716__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaucugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaucacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaagccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17311 - RNA, 9876 nt, Artificial Sequence
  derived and/or modified CDS sequence (opt4) from DENV-2__EU569717__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcuggugaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17312 - RNA, 9876 nt, Artificial Sequence
  derived and/or modified CDS sequence (opt4) from DENV-2__EU569718__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggaguacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacguggaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17313 - RNA, 9876 nt, Artificial Sequence
  derived and/or modified CDS sequence (opt4) from DENV-2__EU596488__SS-prME
accgccggcgugaucaucaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaucaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17314 - RNA, 9876 nt, Artificial Sequence
  derived and/or modified CDS sequence (opt4) from DENV-2__EU596489__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaccauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgaguuccccagcaagcuggccagcgccaucaagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagaaggccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagaaugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17315 - RNA, 9876 nt, Artificial Sequence
  derived and/or modified CDS sequence (opt4) from DENV-2__EU596490__SS-prME
accgccggcgugaucaucaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacgugggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17316 - RNA, 9876 nt, Artificial Sequence
  derived and/or modified CDS sequence (opt4) from DENV-2__EU596491__SS-prME
accgccggcgugaucaucaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacgcccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccacccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccguggacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcagagcccacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17317 - RNA, 9876 nt, Artificial Sequence
  derived and/or modified CDS sequence (opt4) from DENV-2__EU677141__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaucacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17318 - RNA, 9876 nt, Artificial Sequence
  derived and/or modified CDS sequence (opt4) from DENV-2__EU677144__SS-prME
accgccggcaugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggccugaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccauggagaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaucacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugagaaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17319 - RNA, 9876 nt, Artificial Sequence
  derived and/or modified CDS sequence (opt4) from DENV-2__EU677145__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucaucaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccaugcccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccaccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccgugcccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17320 - RNA, 9876 nt, Artificial Sequence
  derived and/or modified CDS sequence (opt4) from DENV-2__EU677146__SS-prME
accgugggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggccaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17321 - RNA, 9876 nt, Artificial Sequence
  derived and/or modified CDS sequence (opt4) from DENV-2__EU687214__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccaacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaucgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17322 - RNA, 9876 nt, Artificial Sequence
  derived and/or modified CDS sequence (opt4) from DENV-2__EU687215__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaagaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccgccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17323 - RNA, 9876 nt, Artificial Sequence
  derived and/or modified CDS sequence (opt4) from DENV-2__EU687216__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucaacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggagcugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17324 - RNA, 9876 nt, Artificial Sequence
  derived and/or modified CDS sequence (opt4) from DENV-2__EU726770__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcaccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17325 - RNA, 9876 nt, Artificial Sequence
  derived and/or modified CDS sequence (opt4) from DENV-2__EU781135__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17326 - RNA, 9876 nt, Artificial Sequence
  derived and/or modified CDS sequence (opt4) from DENV-2__EU687222__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17327 - RNA, 9876 nt, Artificial Sequence
  derived and/or modified CDS sequence (opt4) from DENV-2__EU687223__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcgccuuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17328 - RNA, 9876 nt, Artificial Sequence
  derived and/or modified CDS sequence (opt4) from DENV-2__EU687227__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccagaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17329 - RNA, 9876 nt, Artificial Sequence
  derived and/or modified CDS sequence (opt4) from DENV-2__EU687228__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaacgagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17330 - RNA, 9876 nt, Artificial Sequence
  derived and/or modified CDS sequence (opt4) from DENV-2__EU687230__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaggcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17331 - RNA, 9876 nt, Artificial Sequence
  derived and/or modified CDS sequence (opt4) from DENV-2__EU687231__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaacaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17332 - RNA, 9876 nt, Artificial Sequence
  derived and/or modified CDS sequence (opt4) from DENV-2__EU687199__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaugauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17333 - RNA, 9876 nt, Artificial Sequence
  derived and/or modified CDS sequence (opt4) from DENV-2__EU687235__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccuggugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17334 - RNA, 9876 nt, Artificial Sequence
  derived and/or modified CDS sequence (opt4) from DENV-2__EU687236__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagaaggccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17335 - RNA, 9876 nt, Artificial Sequence
  derived and/or modified CDS sequence (opt4) from DENV-2__EU687237__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17336 - RNA, 9876 nt, Artificial Sequence
  derived and/or modified CDS sequence (opt4) from DENV-2__EU687238__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaccaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17337 - RNA, 9876 nt, Artificial Sequence
  derived and/or modified CDS sequence (opt4) from DENV-2__EU687240__SS-prME
accgugggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggccaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17338 - RNA, 9876 nt, Artificial Sequence
  derived and/or modified CDS sequence (opt4) from DENV-2__EU687241__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacagcaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaccaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaccauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccagguggugaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17339 - RNA, 9876 nt, Artificial Sequence
  derived and/or modified CDS sequence (opt4) from DENV-2__EU687242__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugcuacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugaacgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17340 - RNA, 9876 nt, Artificial Sequence
  derived and/or modified CDS sequence (opt4) from DENV-2__EU687243__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugaacgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17341 - RNA, 9876 nt, Artificial Sequence
  derived and/or modified CDS sequence (opt4) from DENV-2__EU687245__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugaacgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacgccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccaccagcagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccgugaaccaggugagaagccugaucggcaacgaggaguacaccgacuacaugcccagcaugaagagauucagaaaggaggaggaggaggccggcgugcugugguga

SEQ ID NO: 17342 - RNA, 9873 nt, Artificial Sequence
  derived and/or modified CDS sequence (opt4) from DENV-2__HQ541798__SS-prME
accgccggcaugaucuucaugcugauccccaccgugauggccuuccaccugaccaccagaaacggcgagccccacaugaucgugagcagacaggagaagggcaagagccugcuguucaagaccggcgacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagagcgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaaggacaugaagggcgagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagaugcuggagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagccccacacccuguggagcaacgaggugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaagauggagaaguaccagcuggccgugaccaucauggccauccugugcgugcccaacgccgugauccugcagaacgccuggaaggugagcugcaccauccuggccguggugagcgugagcccccuguuccugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagccugcccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggagcagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugagccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccgccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17343 - RNA, 9876 nt, Artificial Sequence
  derived and/or modified CDS sequence (opt4) from DENV-2__JF730053__SS-prME
accgccggcaugaucaucaugcugauccccaccgugauggccuuccaccugaccaccagaaacggcgagccccacaugaucgugagcagacaggagaagggcaagagccugcuguucaagaccggcgacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagagcgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacaugaagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagaugcuggagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacgaggugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaagauggagaaguaccagcuggccgugaccaucauggccauccugugcgugcccaacgccgugauccugcagaacgccuggaaggugagcugcaccauccuggccguggugagcgugagcccccuguuccugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagccugcccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggagcagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugagccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccgccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17344 - RNA, 9876 nt, Artificial Sequence
  derived and/or modified CDS sequence (opt4) from DENV-2__EU529706__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcgugaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcagaaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17345 - RNA, 9876 nt, Artificial Sequence
  derived and/or modified CDS sequence (opt4) from DENV-2__EU482720__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaccauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgccaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagaaggccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaccuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagaaugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17346 - RNA, 9876 nt, Artificial Sequence
  derived and/or modified CDS sequence (opt4) from DENV-2__EU482721__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaccauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagaaugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17347 - RNA, 9876 nt, Artificial Sequence
  derived and/or modified CDS sequence (opt4) from DENV-2__EU482722__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagaguggccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagacccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacgugauccccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17348 - RNA, 9876 nt, Artificial Sequence
  derived and/or modified CDS sequence (opt4) from DENV-2__EU482723__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagagagccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17349 - RNA, 9876 nt, Artificial Sequence
  derived and/or modified CDS sequence (opt4) from DENV-2__EU482724__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccagcagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17350 - RNA, 9876 nt, Artificial Sequence
  derived and/or modified CDS sequence (opt4) from DENV-2__EU482725__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacaccggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugagaaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagccagcugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17351 - RNA, 9876 nt, Artificial Sequence
  derived and/or modified CDS sequence (opt4) from DENV-2__EU482726__SS-prME
accgccggcgugaucgugaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaucggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacgcccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccacccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17352 - RNA, 9876 nt, Artificial Sequence
  derived and/or modified CDS sequence (opt4) from DENV-2__EU482727__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgccuacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaagaaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17353 - RNA, 9876 nt, Artificial Sequence
  derived and/or modified CDS sequence (opt4) from DENV-2__EU482728__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagccugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17354 - RNA, 9876 nt, Artificial Sequence
  derived and/or modified CDS sequence (opt4) from DENV-2__EU482729__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgagaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaucgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugaucgccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgccuacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaagaaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17355 - RNA, 9876 nt, Artificial Sequence
  derived and/or modified CDS sequence (opt4) from DENV-2__EU482731__SS-prME
accgccggcgugaucgugaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacgcccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccacccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcagagcccacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17356 - RNA, 9876 nt, Artificial Sequence
  derived and/or modified CDS sequence (opt4) from DENV-2__EU482732__SS-prME
accgugggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcgccuucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17357 - RNA, 9876 nt, Artificial Sequence
  derived and/or modified CDS sequence (opt4) from DENV-2__EU482733__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17358 - RNA, 9876 nt, Artificial Sequence
  derived and/or modified CDS sequence (opt4) from DENV-2__EU482734__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucaugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcgugggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggcccugaagaucgugaagaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucagaaacgaggaggaggagcagacccugaccauccugaucagaaccggccugcuggugaucagcggcguguuccccgugagcauccccgugaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccuggugagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccaucaccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17359 - RNA, 9876 nt, Artificial Sequence
  derived and/or modified CDS sequence (opt4) from DENV-2__EU482735__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucaugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcgugggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggcccugaagaucgugaagaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucagaaacgaggaggaggagcagacccugaccauccugaucagaaccggccugcuggugaucagcggcguguuccccgugagcauccccgugaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccuggugagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaccaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17360 - RNA, 9876 nt, Artificial Sequence
  derived and/or modified CDS sequence (opt4) from DENV-2__EU482736__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccaugcugcuggugguggugagcuucgugacccugaucaccggcaacaugagcuucagagaccugggcagagugauggugauggugggcgccaccaugaccgacgacaucggcaugggcaucaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugagcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17361 - RNA, 9876 nt, Artificial Sequence
  derived and/or modified CDS sequence (opt4) from DENV-2__EU482737__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccaugcugcuggugguggugagcuucgugacccugaucaccggcaacaugagcuucagagaccugggcagagugauggugauggugggcgccaccaugaccgacgacaucggcaugggcaucaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugagcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17362 - RNA, 9876 nt, Artificial Sequence
  derived and/or modified CDS sequence (opt4) from DENV-2__EU482739__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaaccuggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17363 - RNA, 9876 nt, Artificial Sequence
  derived and/or modified CDS sequence (opt4) from DENV-2__EU482740__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcagcccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagagagugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17364 - RNA, 9876 nt, Artificial Sequence
  derived and/or modified CDS sequence (opt4) from DENV-2__EU482741__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccaugcugcuggugguggugagcuucgugacccugaucaccggcaacaugagcuucagagaccugggcagagugauggugauggugggcgccaccaugaccgacgacaucggcaugggcaucaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17365 - RNA, 9876 nt, Artificial Sequence
  derived and/or modified CDS sequence (opt4) from DENV-2__EU482742__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgcccccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17366 - RNA, 9876 nt, Artificial Sequence
  derived and/or modified CDS sequence (opt4) from DENV-2__EU482744__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugagcaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17367 - RNA, 9876 nt, Artificial Sequence
  derived and/or modified CDS sequence (opt4) from DENV-2__EU482745__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaacagaaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccaccaaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugaagagccugaucggcaacgaggaguacaccgacuacaugcccagcaugaagagauucagaagagaggaggaggaggccggcgugcugugguga

SEQ ID NO: 17368 - RNA, 9876 nt, Artificial Sequence
  derived and/or modified CDS sequence (opt4) from DENV-2__EU482746__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaacagaaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17369 - RNA, 9876 nt, Artificial Sequence
  derived and/or modified CDS sequence (opt4) from DENV-2__EU482590__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccgugcugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccauccuggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacaucagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17370 - RNA, 9876 nt, Artificial Sequence
  derived and/or modified CDS sequence (opt4) from DENV-2__EU482594__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcaucaccuaccuggcccugcuggccgccuucaaggugagacccaccuucgccgccggccugcugcugaagaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgagggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17371 - RNA, 9876 nt, Artificial Sequence
  derived and/or modified CDS sequence (opt4) from DENV-2__EU482604__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagaauccaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17372 - RNA, 9876 nt, Artificial Sequence
  derived and/or modified CDS sequence (opt4) from DENV-2__EU482605__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuggugaccggccaccugaagugcagacugagaauggacaagcugcagcugaagggcaugagcuacagcaugugcaccggcaaguucaagaucgugaaggagaucgccgagacccagcacggcaccaucgugaucagaauccaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggccaaccccgagaucgaggacgccaucuucagaaagaagagacugaccaucauggaccugcaccccggcgccggcaagcccaagagaagccugcccgccaucgugagagaggccaucaagagaggccugagaccccugauccuggccccccccagaguggugcccgccgagauggaggagccccugagaggccugcccaucagauaccagacccccgccaucaagcccgaccacaccggcagagagaucguggcccugaugugccacgcccccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagagacugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17373 - RNA, 9876 nt, Artificial Sequence
  derived and/or modified CDS sequence (opt4) from DENV-2__EU482606__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagaauccaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccaccccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17374 - RNA, 9876 nt, Artificial Sequence
  derived and/or modified CDS sequence (opt4) from DENV-2__EU482607__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcgugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaucgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccgugauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccgacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccuggcccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcugaccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17375 - RNA, 9876 nt, Artificial Sequence
  derived and/or modified CDS sequence (opt4) from DENV-2__EU482608__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagaauccaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagagacugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaucaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga
